United States Patent 11,572,565 (INDUCIBLE CONTROL OF GENE EXPRESSION) - sequence listing, part 3

SEQ ID NO: 1594 - DNA, 7384 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1595 - DNA, 6217 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1596 - DNA, 7222 bp, Artificial Sequence
  synthetic vector
tgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagt

SEQ ID NO: 1597 - DNA, 6286 bp, Artificial Sequence
  synthetic vector
cactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcg

SEQ ID NO: 1598 - DNA, 7153 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1599 - DNA, 6478 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1600 - DNA, 6961 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1601 - DNA, 6685 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1602 - DNA, 6754 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1603 - DNA, 6787 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 1604 - DNA, 6652 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1605 - DNA, 6994 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1606 - DNA, 6445 bp, Artificial Sequence
  synthetic vector
gaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtca

SEQ ID NO: 1607 - DNA, 6469 bp, Artificial Sequence
  synthetic vector
cactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctcaaaagggtggctccccagaagcagatgagcatagcaaagaaaaagaaggtgagaaggcggcggcgccgtcgatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcg

SEQ ID NO: 1608 - DNA, 7012 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagaaaagggtggctccccagaagcagatgagcatagcaaagaaaaagaaggtgagaaggcggcggcgccgtcgatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 1609 - DNA, 6838 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacaaaagggtggctccccagaagcagatgagcatagcaaagaaaaagaaggtgagaaggcggcggcgccgtcgatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 1610 - DNA, 291 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacacccaagaaaaagcggaaggtgtga

SEQ ID NO: 1611 - DNA, 2670 bp, Artificial Sequence
  synthetic polynucleotide
atgggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1612 - DNA, 558 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctcccaagaaaaagcggaaggtgtga

SEQ ID NO: 1613 - DNA, 2403 bp, Artificial Sequence
  synthetic polynucleotide
atgttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1614 - DNA, 1179 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccaagaaaaagcggaaggtgtga

SEQ ID NO: 1615 - DNA, 1782 bp, Artificial Sequence
  synthetic polynucleotide
atgcccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1616 - DNA, 1395 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccccccaagaaaaagcggaaggtgtga

SEQ ID NO: 1617 - DNA, 1566 bp, Artificial Sequence
  synthetic polynucleotide
atggctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1618 - DNA, 1704 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtga

SEQ ID NO: 1619 - DNA, 1257 bp, Artificial Sequence
  synthetic polynucleotide
atgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1620 - DNA, 1722 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagcccaagaaaaagcggaaggtgtga

SEQ ID NO: 1621 - DNA, 1239 bp, Artificial Sequence
  synthetic polynucleotide
atggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1622 - DNA, 1776 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggccccaagaaaaagcggaaggtgtga

SEQ ID NO: 1623 - DNA, 1185 bp, Artificial Sequence
  synthetic polynucleotide
atgaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1624 - DNA, 1992 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagcccaagaaaaagcggaaggtgtga

SEQ ID NO: 1625 - DNA, 969 bp, Artificial Sequence
  synthetic polynucleotide
atggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1626 - DNA, 2079 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggcccaagaaaaagcggaaggtgtga

SEQ ID NO: 1627 - DNA, 882 bp, Artificial Sequence
  synthetic polynucleotide
atgagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1628 - DNA, 2268 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatcccaagaaaaagcggaaggtgtga

SEQ ID NO: 1629 - DNA, 693 bp, Artificial Sequence
  synthetic polynucleotide
atgctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1630 - DNA, 2334 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactcccaagaaaaagcggaaggtgtga

SEQ ID NO: 1631 - DNA, 627 bp, Artificial Sequence
  synthetic polynucleotide
atggcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1632 - DNA, 2412 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcccccaagaaaaagcggaaggtgtga

SEQ ID NO: 1633 - DNA, 549 bp, Artificial Sequence
  synthetic polynucleotide
atgaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1634 - DNA, 2448 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagccccaagaaaaagcggaaggtgtga

SEQ ID NO: 1635 - DNA, 513 bp, Artificial Sequence
  synthetic polynucleotide
atggacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1636 - DNA, 2736 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagccccaagaaaaagcggaaggtgtga

SEQ ID NO: 1637 - DNA, 225 bp, Artificial Sequence
  synthetic polynucleotide
atgggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1638 - DNA, 474 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgcccaagaaaaagcggaaggtgtga

SEQ ID NO: 1639 - DNA, 2487 bp, Artificial Sequence
  synthetic polynucleotide
atggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1640 - DNA, 567 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaatcccaagaaaaagcggaaggtgtga

SEQ ID NO: 1641 - DNA, 2394 bp, Artificial Sequence
  synthetic polynucleotide
atgaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1642 - DNA, 672 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagcccaagaaaaagcggaaggtgtga

SEQ ID NO: 1643 - DNA, 2289 bp, Artificial Sequence
  synthetic polynucleotide
atgggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1644 - DNA, 816 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctccccaagaaaaagcggaaggtgtga

SEQ ID NO: 1645 - DNA, 2145 bp, Artificial Sequence
  synthetic polynucleotide
atggacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1646 - DNA, 978 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattcccaagaaaaagcggaaggtgtga

SEQ ID NO: 1647 - DNA, 1980 bp, Artificial Sequence
  synthetic polynucleotide
atgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1648 - DNA, 1047 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatcccaagaaaaagcggaaggtgtga

SEQ ID NO: 1649 - DNA, 1914 bp, Artificial Sequence
  synthetic polynucleotide
atgatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1650 - DNA, 1239 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcccccaagaaaaagcggaaggtgtga

SEQ ID NO: 1651 - DNA, 1722 bp, Artificial Sequence
  synthetic polynucleotide
atgttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1652 - DNA, 1446 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgcccaagaaaaagcggaaggtgtga

SEQ ID NO: 1653 - DNA, 1515 bp, Artificial Sequence
  synthetic polynucleotide
atgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1654 - DNA, 1548 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaaccccaagaaaaagcggaaggtgtga

SEQ ID NO: 1655 - DNA, 1413 bp, Artificial Sequence
  synthetic polynucleotide
atggctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1656 - DNA, 1755 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaaccccaagaaaaagcggaaggtgtga

SEQ ID NO: 1657 - DNA, 1206 bp, Artificial Sequence
  synthetic polynucleotide
atgggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1658 - DNA, 1230 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctcaaaagggtggctccccagaagcagatgagcatagcaaagaaaaagaaggtgagaaggcggcggcgccgtcgatga

SEQ ID NO: 1659 - DNA, 1773 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagaaaagggtggctccccagaagcagatgagcatagcaaagaaaaagaaggtgagaaggcggcggcgccgtcgatga

SEQ ID NO: 1660 - DNA, 1599 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacaaaagggtggctccccagaagcagatgagcatagcaaagaaaaagaaggtgagaaggcggcggcgccgtcgatga

SEQ ID NO: 1661 - protein, 96 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTPKKKRKV

SEQ ID NO: 1662 - protein, 889 aa, Artificial Sequence
  synthetic polypeptide
MGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1663 - protein, 185 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAPKKKRKV

SEQ ID NO: 1664 - protein, 800 aa, Artificial Sequence
  synthetic polypeptide
MFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1665 - protein, 392 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPKKKRKV

SEQ ID NO: 1666 - protein, 593 aa, Artificial Sequence
  synthetic polypeptide
MPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1667 - protein, 464 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPPKKKRKV

SEQ ID NO: 1668 - protein, 521 aa, Artificial Sequence
  synthetic polypeptide
MAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1669 - protein, 567 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLPKKKRKV

SEQ ID NO: 1670 - protein, 418 aa, Artificial Sequence
  synthetic polypeptide
MSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1671 - protein, 573 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKPKKKRKV

SEQ ID NO: 1672 - protein, 412 aa, Artificial Sequence
  synthetic polypeptide
MALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1673 - protein, 591 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGPKKKRKV

SEQ ID NO: 1674 - protein, 394 aa, Artificial Sequence
  synthetic polypeptide
MKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1675 - protein, 663 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKPKKKRKV

SEQ ID NO: 1676 - protein, 322 aa, Artificial Sequence
  synthetic polypeptide
MDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1677 - protein, 692 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRPKKKRKV

SEQ ID NO: 1678 - protein, 293 aa, Artificial Sequence
  synthetic polypeptide
MSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1679 - protein, 755 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINPKKKRKV

SEQ ID NO: 1680 - protein, 230 aa, Artificial Sequence
  synthetic polypeptide
MLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1681 - protein, 777 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETPKKKRKV

SEQ ID NO: 1682 - protein, 208 aa, Artificial Sequence
  synthetic polypeptide
MAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1683 - protein, 803 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESAPKKKRKV

SEQ ID NO: 1684 - protein, 182 aa, Artificial Sequence
  synthetic polypeptide
MNPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1685 - protein, 815 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSPKKKRKV

SEQ ID NO: 1686 - protein, 170 aa, Artificial Sequence
  synthetic polypeptide
MDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1687 - protein, 911 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSPKKKRKV

SEQ ID NO: 1688 - protein, 74 aa, Artificial Sequence
  synthetic polypeptide
MGKVSEYFDAVNDEKKYNDRLLKLLCVPFGYCIPRFKNLSIEALFDRNEAAKFDKEKKKVSGNSGSGPKKKRKV

SEQ ID NO: 1689 - protein, 157 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLPKKKRKV

SEQ ID NO: 1690 - protein, 828 aa, Artificial Sequence
  synthetic polypeptide
MDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1691 - protein, 188 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNPKKKRKV

SEQ ID NO: 1692 - protein, 797 aa, Artificial Sequence
  synthetic polypeptide
MNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1693 - protein, 223 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEPKKKRKV

SEQ ID NO: 1694 - protein, 762 aa, Artificial Sequence
  synthetic polypeptide
MGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1695 - protein, 271 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLPKKKRKV

SEQ ID NO: 1696 - protein, 714 aa, Artificial Sequence
  synthetic polypeptide
MDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1697 - protein, 325 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIPKKKRKV

SEQ ID NO: 1698 - protein, 659 aa, Artificial Sequence
  synthetic polypeptide
MKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1699 - protein, 348 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDPKKKRKV

SEQ ID NO: 1700 - protein, 637 aa, Artificial Sequence
  synthetic polypeptide
MMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1701 - protein, 412 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSPKKKRKV

SEQ ID NO: 1702 - protein, 573 aa, Artificial Sequence
  synthetic polypeptide
MFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1703 - protein, 481 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMPKKKRKV

SEQ ID NO: 1704 - protein, 504 aa, Artificial Sequence
  synthetic polypeptide
MFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1705 - protein, 515 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNPKKKRKV

SEQ ID NO: 1706 - protein, 470 aa, Artificial Sequence
  synthetic polypeptide
MAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1707 - protein, 584 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENPKKKRKV

SEQ ID NO: 1708 - protein, 401 aa, Artificial Sequence
  synthetic polypeptide
MGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1709 - protein, 409 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLKRVAPQKQMSIAKKKKVRRRRRRR

SEQ ID NO: 1710 - protein, 590 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKKRVAPQKQMSIAKKKKVRRRRRRR

SEQ ID NO: 1711 - protein, 532 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNKRVAPQKQMSIAKKKKVRRRRRRR

SEQ ID NO: 1712 - DNA, 6403 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1713 - DNA, 5956 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcgcacgcgtgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1714 - DNA, 7705 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcggccggccgccgccaccatgatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1715 - DNA, 6542 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgcgtaccgagctcttacgcgtgctagatcaaagggggtaagatcaaagggggtaagatcaaagggggtaagatcaaagggggtaagatcaaagggggtaagatcaaagggcgctagatcaaagggggtaagatcaaagggggtaagatcaaagggggtaagataaagggggtaagatcaaagggggtaagatcaaagggcgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1716 - DNA, 6095 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgcgtaccgagctcttacgcgtgctagatcaaagggggtaagatcaaagggggtaagatcaaagggggtaagatcaaagggggtaagatcaaagggggtaagatcaaagggcgctagatcaaagggggtaagatcaaagggggtaagatcaaagggggtaagataaagggggtaagatcaaagggggtaagatcaaagggcgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1717 - DNA, 7844 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgcgtaccgagctcttacgcgtgctagatcaaagggggtaagatcaaagggggtaagatcaaagggggtaagatcaaagggggtaagatcaaagggggtaagatcaaagggcgctagatcaaagggggtaagatcaaagggggtaagatcaaagggggtaagataaagggggtaagatcaaagggggtaagatcaaagggcgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1718 - DNA, 6417 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1719 - DNA, 5970 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1720 - DNA, 7716 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1721 - DNA, 6508 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgctagcccgggctcgagagccagacaaaaagccagacatttagccagacactcgagagccagacaaaaagccagacatttagccagacactcgagagccagacaaaaagccagacatttagccagacactcgagagccagacaaaaagccagacatttagccagacactcgagatctgggctataaaagggggtgggggcgcgttcgtcctcactctcttccaagcttggcattccggtactgttggtaaaggccggcccttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1722 - DNA, 6061 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgctagcccgggctcgagagccagacaaaaagccagacatttagccagacactcgagagccagacaaaaagccagacatttagccagacactcgagagccagacaaaaagccagacatttagccagacactcgagagccagacaaaaagccagacatttagccagacactcgagatctgggctataaaagggggtgggggcgcgttcgtcctcactctcttccaagcttggcattccggtactgttggtaaaggccggcccttaagatccattactcgcatccattctcaggctgtctcgtctcgtctcgcacgcgtgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1723 - DNA, 7807 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgctagcccgggctcgagagccagacaaaaagccagacatttagccagacactcgagagccagacaaaaagccagacatttagccagacactcgagagccagacaaaaagccagacatttagccagacactcgagagccagacaaaaagccagacatttagccagacactcgagatctgggctataaaagggggtgggggcgcgttcgtcctcactctcttccaagcttggcattccggtactgttggtaaaggccggcccttaagatccattactcgcatccattctcaggctgtctcgtctcgtctcggccggccgccgccaccatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1724 - DNA, 8595 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1725 - DNA, 8148 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcgcacgcgtgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1726 - DNA, 9897 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcggccggccgccgccaccatgatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1727 - DNA, 8609 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1728 - DNA, 8162 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1729 - DNA, 9908 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgatatctcgcacagtgccgccaccatggccaagctgacaagcgccgtgcctgtgctgaccgccagagatgtggctggcgccgtggaattttggaccgacagactgggcttcagccgggacttcgtggaagatgacttcgccggcgtcgtgcgggacgacgtgaccctgtttatctccgccgtgcaggaccaggtggtgcccgataatactctggcctgggtgtgggtgcgcggcctggatgaactgtatgccgagtggagcgaggtggtgtccaccaacttcagggatgccagcggccctgccatgaccgagattggagaacagccctggggcagagagttcgccctgagagatcctgccggcaactgcgtgcacttcgtggccgaggaacaggacggaagcggagctactaacttcagcctgctgaagcaggctggagacgtggaggagaaccctggacctatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaaatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1730 - DNA, 5650 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccttacgcgtgctagctgactaatgactaatgactaatgactaatgactaatgactaatgactaatgactaaagatctgggtatatagtttaaacttcgcatattaaggtgacgcgtgtggcctcgaacaccgagcgaccctgcagcgacccgcttaagatccattactcgcatccattctcaggctgtctcgtctcgtctcggccggccgccgccaccatggcggaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcgggtccgtgatcgcagaggatcggtgcgccgaggtcgagtcaaaactaggcctgcactatcctgcctcattcatcccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccaaccatctggagttcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1731 - DNA, 5558 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgcgtaccgagctcttacgcgtgctagatcaaagggggtaagatcaaagggggtaagatcaaagggggtaagatcaaagggggtaagatcaaagggggtaagatcaaagggcgctagatcaaagggggtaagatcaaagggggtaagatcaaagggggtaagataaagggggtaagatcaaagggggtaagatcaaagggcgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1732 - DNA, 5415 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgccgacggtatcgatgggaatttccgggaatttccgggaatttccgggaatttccgggaatttccgggaatttccgctagcccgggctcgagatctagactctagagggtatataatggaagctcgaattccagcttggcattccggtactgttggtaaaggccggcccttaagatccattactcgcatccattctcaggctgtctcgtctcgtctcggccggccgccgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1733 - DNA, 5515 bp, Artificial Sequence
  synthetic vector
gtcgacattgattattgactagtgaaggggcaggagagccaggggcatgagatggtggacgaggaagggggacagggaagcctgagcgcctctcctgggcttgccaaggactcaaacccagaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacagccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccaatcgccggcgaattcgcggccgctagcccgggctcgagagccagacaaaaagccagacatttagccagacactcgagagccagacaaaaagccagacatttagccagacactcgagagccagacaaaaagccagacatttagccagacactcgagagccagacaaaaagccagacatttagccagacactcgagatctgggctataaaagggggtgggggcgcgttcgtcctcactctcttccaagcttggcattccggtactgttggtaaaggccggcccttaagatccattactcgcatccattctcaggctgtctcgtctcgtctcggccggccgccgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgggtaccggcgcgccctgtccctagtggccccactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcagggaaggatctgggccagccgtagaggtgacccaggccacaagctgcagacagaaagcggcacaggcccaggggagagaatgccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1734 - DNA, 3003 bp, Artificial Sequence
  synthetic polynucleotide
atgagccccaagaagaagagaaaggtggaggccagcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtggcggccgcttacccatacgatgttccagattacgcttga

SEQ ID NO: 1735 - protein, 567 aa, Artificial Sequence; identical to SEQ ID NO: 1669
  synthetic polypeptide

SEQ ID NO: 1736 - DNA, 63 bp, Artificial Sequence
  synthetic polynucleotide
ttcgcatattaaggtgacgcgtgtggcctcgaacaccgagcgaccctgcagcgacccgcttaa

SEQ ID NO: 1737 - DNA, 119 bp, Artificial Sequence
  synthetic polynucleotide
gggaatttccgggaatttccgggaatttccgggaatttccgggaatttccgggaatttccgctagcccgggctcgagatctagactctagagggtatataatggaagctcgaattccag

SEQ ID NO: 1738 - DNA, 205 bp, Artificial Sequence
  synthetic polynucleotide
agccagacaaaaagccagacatttagccagacactcgagagccagacaaaaagccagacatttagccagacactcgagagccagacaaaaagccagacatttagccagacactcgagagccagacaaaaagccagacatttagccagacactcgagatctgggctataaaagggggtgggggcgcgttcgtcctcactctcttcc

SEQ ID NO: 1739 - DNA, 234 bp, Artificial Sequence
  synthetic polynucleotide
gatcaaagggggtaagatcaaagggggtaagatcaaagggggtaagatcaaagggggtaagatcaaagggggtaagatcaaagggcgctagatcaaagggggtaagatcaaagggggtaagatcaaagggggtaagataaagggggtaagatcaaagggggtaagatcaaagggcgctagcccgggctcgagatctagactctagagggtatataatggaagctcgaattccag

SEQ ID NO: 1740 - DNA, 5739 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1741 - DNA, 6853 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1742 - DNA, 6162 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacacctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1743 - DNA, 6430 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1744 - DNA, 6780 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgtccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1745 - DNA, 5812 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1746 - DNA, 6846 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1747 - DNA, 5746 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1748 - DNA, 6352 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggttccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1749 - DNA, 6007 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgtggctgatgaccccaacaactacctgttctgccgggtcagaaagaatggtgtggctgccccttctgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1750 - DNA, 6418 bp, Artificial Sequence
  synthetic vector
ggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttcttccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggt

SEQ ID NO: 1751 - DNA, 5941 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1752 - DNA, 6433 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1753 - DNA, 5926 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacctccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1754 - DNA, 6475 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccacccgggccctggaagggatctttgaggccacccaccgctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1755 - DNA, 5884 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1756 - DNA, 6838 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccacccgggccctggaagggatctttgaggccacccaccgctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1757 - DNA, 6247 bp, Artificial Sequence
  synthetic vector
aactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaa

SEQ ID NO: 1758 - DNA, 6352 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggttccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1759 - DNA, 6781 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttcttccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1760 - DNA, 6796 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1761 - DNA, 6370 bp, Artificial Sequence
  synthetic vector
aactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgtggctgatgaccccaacaactacctgttctgccgggtcagaaagaatggtgtggctgccccttctgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaa

SEQ ID NO: 1762 - DNA, 6304 bp, Artificial Sequence
  synthetic vector
aactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaa

SEQ ID NO: 1763 - DNA, 6289 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacctccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1764 - DNA, 6102 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1765 - DNA, 6525 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacacctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1766 - DNA, 7143 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1767 - DNA, 7209 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1768 - DNA, 7216 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1769 - DNA, 6793 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1770 - DNA, 6175 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1771 - DNA, 6109 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcatcagataccccgcctggaacggcatcatcagccaggaggtgctggactacctgagcagctacatcaacaggcggatccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1772 - DNA, 6727 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagccctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1773 - DNA, 7216 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1774 - DNA, 7312 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1775 - DNA, 7741 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1776 - DNA, 7144 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1777 - DNA, 6655 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1778 - DNA, 6559 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1779 - DNA, 6130 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacccagggcacccccatcgagaagagagccagcatcacctgggccaagcctcccaccgacgacgacgaggatgacgcccaggacggcaccgaggacgtggccgcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1780 - DNA, 6267 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagatccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1781 - DNA, 6537 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1782 - DNA, 6651 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgactccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1783 - DNA, 6828 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1784 - DNA, 6852 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagacctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1785 - DNA, 6915 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacccacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1786 - DNA, 6645 bp, Artificial Sequence
  synthetic vector
cccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctc

SEQ ID NO: 1787 - DNA, 6531 bp, Artificial Sequence
  synthetic vector
ttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgag

SEQ ID NO: 1788 - DNA, 6354 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1789 - DNA, 6330 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1790 - DNA, 507 bp, Artificial Sequence
  synthetic polynucleotide
atgagccagttcgacatcctgtgcaagaccccccccaaggtgctggtgcggcagttcgtggagagattcgagaggcccagctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1791 - DNA, 1614 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1792 - DNA, 930 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacacctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1793 - DNA, 1191 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1794 - DNA, 1548 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgtccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1795 - DNA, 573 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1796 - DNA, 1614 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1797 - DNA, 507 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcatcagataccccgcctggaacggcatcatcagccaggaggtgctggactacctgagcagctacatcaacaggcggatccccaagaaaaagcggaaggtgtga

SEQ ID NO: 1798 - DNA, 1113 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggttccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1799 - DNA, 768 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgtggctgatgaccccaacaactacctgttctgccgggtcagaaagaatggtgtggctgccccttctgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1800 - DNA, 1179 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttcttccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1801 - DNA, 702 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1802 - DNA, 1194 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1803 - DNA, 687 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacctccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1804 - DNA, 1236 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccacccgggccctggaagggatctttgaggccacccaccgctccggagggtctggctccggatcaagtggtggcagcggtaccatggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1805 - DNA, 645 bp, Artificial Sequence
  synthetic polynucleotide
atggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1806 - DNA, 1599 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccacccgggccctggaagggatctttgaggccacccaccgctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1807 - DNA, 1008 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1808 - DNA, 1113 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggttccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1809 - DNA, 1542 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttcttccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1810 - DNA, 1557 bp, Artificial Sequence
  synthetic polynucleotide
atgtccaacctgctgactgtgcaccaaaacctgcctgccctccctgtggatgccacctctgatgaagtcaggaagaacctgatggacatgttcagggacaggcaggccttctctgaacacacctggaagatgctcctgtctgtgtgcagatcctgggctgcctggtgcaagctgaacaacaggaaatggttccctgctgaacctgaggatgtgagggactacctcctgtacctgcaagccagaggcctggctgtgaagaccatccaacagcacctgggccagctcaacatgctgcacaggagatctggcctgcctcgcccttctgactccaatgctgtgtccctggtgatgaggagaatcagaaaggagaatgtggatgctggggagagagccaagcaggccctggcctttgaacgcactgactttgaccaagtcagatccctgatggagaactctgacagatgccaggacatcaggaacctggccttcctgggcattgcctacaacaccctgctgcgcattgccgaaattgccagaatcagagtgaaggacatctcccgcaccgatggtgggagaatgctgatccacattggcaggaccaagaccctggtgtccacagctggtgtggagaaggccctgtccctgggggttaccaagctggtggagagatggatctctgtgtctggtgtggctgatgaccccaacaactacctgttctgccgggtcagaaagaatggtgtggctgccccttctgccacctcccaactgtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1811 - DNA, 1131 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgtggctgatgaccccaacaactacctgttctgccgggtcagaaagaatggtgtggctgccccttctgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1812 - DNA, 1065 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgccacctcccaactgtccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1813 - DNA, 1050 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacctccacccgggccctggaagggatctttgaggccacccaccgcctgatctatggtgccaaggatgactctgggcagagatacctggcctggtctggccactctgccagagtgggtgctgccagggacatggccagggctggtgtgtccatccctgaaatcatgcaggctggtggctggaccaatgtgaacattgtgatgaactacatcagaaacctggactctgagactggggccatggtgaggctgctcgaggatggggaccccaagaaaaagcggaaggtgtga

SEQ ID NO: 1814 - DNA, 870 bp, Artificial Sequence
  synthetic polynucleotide
atgagccagttcgacatcctgtgcaagaccccccccaaggtgctggtgcggcagttcgtggagagattcgagaggcccagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1815 - DNA, 1293 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacacctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1816 - DNA, 1911 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1817 - DNA, 1977 bp, Artificial Sequence
  synthetic polynucleotide
atgagccagttcgacatcctgtgcaagaccccccccaaggtgctggtgcggcagttcgtggagagattcgagaggcccagcggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1818 - DNA, 1977 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgagaagatcgccagctgtgccgccgagctgacctacctgtgctggatgatcacccacaacggcaccgccatcaagagggccaccttcatgagctacaacaccatcatcagcaacagcctgagcttcgacatcgtgaacaagagcctgcagttcaagtacaagacccagaaggccaccatcctggaggccagcctgaagaagctgatccccgcctgggagttcaccatcatcccttacaacggccagaagcaccagagcgacatcaccgacatcgtgtccagcctgcagctgcagttcgagagcagcgaggaggccgacaagggcaacagccacagcaagaagatgctgaaggccctgctgtccgagggcgagagcatctgggagatcaccgagaagatcctgaacagcttcgagtacaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1819 - DNA, 1554 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcaggttcaccaagaccaagaccctgtaccagttcctgttcctggccacattcatcaactgcggcaggttcagcgacatcaagaacgtggaccccaagagcttcaagctggtgcagaacaagtacctgggcgtgatcattcagtgcctggtgaccgagaccaagacaagcgtgtccaggcacatctactttttcagcgccagaggcaggatcgaccccctggtgtacctggacgagttcctgaggaacagcgagcccgtgctgaagagagtgaacaggaccggcaacagcagcagcaacaagcaggagtaccagctgctgaaggacaacctggtgcgcagctacaacaaggccctgaagaagaacgccccctaccccatcttcgctatcaagaacggccctaagagccacatcggcaggcacctgatgaccagctttctgagcatgaagggcctgaccgagctgacaaacgtggtgggcaactggagcgacaagagggcctccgccgtggccaggaccacctacacccaccagatcaccgccatccccgaccactacttcgccctggtgtccaggtactacgcctacgaccccatcagcaaggagatgatcgccctgaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1820 - DNA, 936 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaaggacgagaccaaccccatcgaggagtggcagcacatcgagcagctgaagggcagcgccgagggcagcatcagataccccgcctggaacggcatcatcagccaggaggtgctggactacctgagcagctacatcaacaggcggatccccaagaaaaagcggaaggtgtga

SEQ ID NO: 1821 - DNA, 870 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccagcatcagataccccgcctggaacggcatcatcagccaggaggtgctggactacctgagcagctacatcaacaggcggatccccaagaaaaagcggaaggtgtga

SEQ ID NO: 1822 - DNA, 1488 bp, Artificial Sequence
  synthetic polynucleotide
atggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagccctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1823 - DNA, 1977 bp, Artificial Sequence
  synthetic polynucleotide
atggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1824 - DNA, 2073 bp, Artificial Sequence
  synthetic polynucleotide
atggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagtccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1825 - DNA, 2502 bp, Artificial Sequence
  synthetic polynucleotide
atggatacctacgccggagcctacgacagacagagccgggagagagagaacagcagcgccgccagccccgccacccagagaagcgccaacgaggataaggccgccgatctgcagagagaggtggagagggacggcggcagattcagatttgtgggccacttcagcgaggcccctggcaccagcgccttcggcaccgccgagagacccgagttcgagagaatcctgaacgagtgtagggccggcaggctgaacatgatcatcgtgtacgacgtgtcccggttcagcaggctgaaggtgatggacgccatccctatcgtgtccgagctgctggccctgggcgtgaccatcgtgtccacccaggaaggcgtctttagacagggcaacgtgatggacctgatccacctgatcatgaggctggacgccagccacaaggagagcagcctgaagagcgccaagatcctggacaccaagaacctgcagagggagctgggcggctatgtgggcggcaaggccccctacggcttcgagctggtgtccgagaccaaggagatcacccggaacggcaggatggtgaacgtggtgatcaacaagctggcccacagcaccacccccctgaccggccccttcgagtttgagcccgacgtgatcaggtggtggtggcgggagatcaagacccacaagcacctgcctttcaagcccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1826 - DNA, 1905 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcagccaggccgccatccaccccggcagcatcaccggcctgtgtaagagaatggacgccgacgccgtgcccaccagaggcgagaccatcggcaagaaaaccgccagcagcgcctgggaccccgccaccgtgatgagaatcctgagggaccctaggatcgccggcttcgccgccgaggtgatctacaagaagaagcccgacggcacccccaccaccaagatcgagggctacagaatccagagagaccccatcaccctgagacctgtggagctggactgtggccctatcatcgagcctgccgagtggtacgagctgcaggcctggctggacggcagaggcagaggcaagggcctgagcagaggccaggccatcctgagcgccatggacaagctgtactgtgagtgtggcgccgtgatgaccagcaagagaggcgaggagagcatcaaggacagctaccggtgccggagaagaaaggtggtggaccccagcgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtga

SEQ ID NO: 1827 - DNA, 1416 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgcccctggccagcacgagggcacctgtaatgtgagcatggccgccctggacaagttcgtggccgagcggatcttcaacaagatccggcacgccgagggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtga

SEQ ID NO: 1828 - DNA, 1320 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgacgaggagaccctggccctgctgtgggaggccgccagaagattcggcaagctgaccgaggcccccgagaagagcggcgagagggccaacctggtggccgagagagccgacgccctgaacgccctggaggagctgtacgaggacagagccgccggagcctatgacggccctgtgggcaggaagcacttcagaaagcagcaggccgccctgaccctgagacagcagggcgccgaggaaagactggccgagctggaggccgccgaggcccctaagctgcccctggatcagtggttccccgaggatgccgacgccgaccccaccggccccaagtcctggtggggcagagccagcgtggacgacaagagggtgttcgtgggcctgttcgtggataagatcgtggtgaccaagagcaccaccggcaggggccagggcacccccatcgagaagagagccagcatcacctgggccaagcctcccaccgacgacgacgaggatgacgcccaggacggcaccgaggacgtggccgcccccaagaaaaagcggaaggtgtga

SEQ ID NO: 1829 - DNA, 891 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacccagggcacccccatcgagaagagagccagcatcacctgggccaagcctcccaccgacgacgacgaggatgacgcccaggacggcaccgaggacgtggccgcccccaagaaaaagcggaaggtgtga

SEQ ID NO: 1830 - DNA, 1035 bp, Artificial Sequence
  synthetic polynucleotide
atgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagatccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1831 - DNA, 1305 bp, Artificial Sequence
  synthetic polynucleotide
atgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1832 - DNA, 1419 bp, Artificial Sequence
  synthetic polynucleotide
atgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgactccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1833 - DNA, 1596 bp, Artificial Sequence
  synthetic polynucleotide
atgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1834 - DNA, 1620 bp, Artificial Sequence
  synthetic polynucleotide
atgatcgagaaccagctgagcctgctgggcgacttttctggcgtgcggcccgacgatgtgaaaaccgccattcaggccgcccagaaaaagggcatcaacgtggccgagaacgagcagttcaaggccgccttcgagcatctgctgaacgagttcaagaagcgggaagagagatacagccccaacaccctgcggcggctggaaagcgcctggacctgcttcgtggattggtgcctggccaaccacagacacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagacctccggagggtctggctccggatcaagtggtggcagcggtaccatggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcatcccaagaaaaagcggaaggtgtga

SEQ ID NO: 1835 - DNA, 1683 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtacccacagcctgcctgccacccccgataccgtggaagccttcttcatcgagcgggccgaggaactgcaccggaacaccctgagcgtgtacagatgggccatcagccgggtgcacagagtggccggatgccctgatccctgcctggacatctacgtggaagatcggctgaaggccattgcccggaagaaagtgcgggaaggcgaggccgtgaagcaggccagccctttcaacgagcagcatctgctgaagctgaccagcctgtggtacagaagcgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtga

SEQ ID NO: 1836 - DNA, 1413 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccgacaagctgctgctgcggcggaacctggctctgctggctgtggcctacgagagcatgctgagagccagcgagctggccaacatccgggtgtccgatatggaactggccggcgacggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtga

SEQ ID NO: 1837 - DNA, 1299 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggaaccgccatcctgaccatccctatcaccaagaccaaccactccggcgagcccgatacctgcatcctgtcccaggatgtggtgtccctgctgatggactacaccgaggccggcaagctggatatgagcagcgacggcttcctgttcgtgggcgtgtccaagcacaacacctgtatcaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtga

SEQ ID NO: 1838 - DNA, 1122 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccaagcccaagaaggacaagcagaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtga

SEQ ID NO: 1839 - DNA, 1098 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcattccggagggtctggctccggatcaagtggtggcagcggtaccggcgaggtgctgcacaagcccatcaccaccaagacagtggaaggcgtgttctacagcgcctgggagacactggacctgggcagacagggcgtgaagcctttcacagcccacagcgccagagtgggagccgctcaggacctgctgaagaagggctacaataccctgcagatccagcagtccggccggtggtctagcggagccatggtggccagatacggcagagccatcctggctagggatggcgctatggcccacagcagagtgaaaaccagatccgcccccatgcagtggggcaaggacgagaaggaccccaagaaaaagcggaaggtgtga

SEQ ID NO: 1840 - protein, 168 aa, Artificial Sequence
  synthetic polypeptide
MSQFDILCKTPPKVLVRQFVERFERPSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1841 - protein, 537 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIPKKKRKV

SEQ ID NO: 1842 - protein, 309 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1843 - protein, 396 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIPKKKRKV

SEQ ID NO: 1844 - protein, 515 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1845 - protein, 190 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTKDETNPIEEWQHIEQLKGSAEGSIRYPAWNGIISQEVLDYLSSYINRRIPKKKRKV

SEQ ID NO: 1846 - protein, 537 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1847 - protein, 168 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSIRYPAWNGIISQEVLDYLSSYINRRIPKKKRKV

SEQ ID NO: 1848 - protein, 370 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1849 - protein, 255 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1850 - protein, 392 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1851 - protein, 233 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTATSQLSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1852 - protein, 397 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1853 - protein, 228 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1854 - protein, 411 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1855 - protein, 214 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTLIYGAKDDSGQRYLAWSGHSARVGAARDMARAGVSIPEIMQAGGWTNVNIVMNYIRNLDSETGAMVRLLEDGDPKKKRKV

SEQ ID NO: 1856 - protein, 532 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1857 - protein, 335 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTLIYGAKDDSGQRYLAWSGHSARVGAARDMARAGVSIPEIMQAGGWTNVNIVMNYIRNLDSETGAMVRLLEDGDPKKKRKV

SEQ ID NO: 1858 - protein, 370 aa, Artificial Sequence; identical to SEQ ID NO: 1848
  synthetic polypeptide

SEQ ID NO: 1859 - protein, 513 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1860 - protein, 518 aa, Artificial Sequence
  synthetic polypeptide
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1861 - protein, 376 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1862 - protein, 354 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTATSQLSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1863 - protein, 349 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSTRALEGIFEATHRLIYGAKDDSGQRYLAWSGHSARVGAARDMARAGVSIPEIMQAGGWTNVNIVMNYIRNLDSETGAMVRLLEDGDPKKKRKV

SEQ ID NO: 1864 - protein, 289 aa, Artificial Sequence
  synthetic polypeptide
MSQFDILCKTPPKVLVRQFVERFERPSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1865 - protein, 430 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1866 - protein, 636 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1867 - protein, 658 aa, Artificial Sequence
  synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1868 - protein, 658 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIPKKKRKV

SEQ ID NO: 1869 - protein, 517 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIPKKKRKV

SEQ ID NO: 1870 - protein, 311 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTKDETNPIEEWQHIEQLKGSAEGSIRYPAWNGIISQEVLDYLSSYINRRIPKKKRKV

SEQ ID NO: 1871 - protein, 289 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTSIRYPAWNGIISQEVLDYLSSYINRRIPKKKRKV

SEQ ID NO: 1872 - protein, 495 aa, Artificial Sequence
  synthetic polypeptide
MDTYAGAYDRQSRERENSSAASPATQRSANEDKAADLQREVERDGGRFRFVGHFSEAPGTSAFGTAERPEFERILNECRAGRLNMIIVYDVSRFSRLKVMDAIPIVSELLALGVTIVSTQEGVFRQGNVMDLIHLIMRLDASHKESSLKSAKILDTKNLQRELGGYVGGKAPYGFELVSETKEITRNGRMVNVVINKLAHSTTPLTGPFEFEPDVIRWWWREIKTHKHLPFKPSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1873 - protein, 658 aa, Artificial Sequence
  synthetic polypeptide
MDTYAGAYDRQSRERENSSAASPATQRSANEDKAADLQREVERDGGRFRFVGHFSEAPGTSAFGTAERPEFERILNECRAGRLNMIIVYDVSRFSRLKVMDAIPIVSELLALGVTIVSTQEGVFRQGNVMDLIHLIMRLDASHKESSLKSAKILDTKNLQRELGGYVGGKAPYGFELVSETKEITRNGRMVNVVINKLAHSTTPLTGPFEFEPDVIRWWWREIKTHKHLPFKPGSQAAIHPGSITGLCKRMDADAVPTRGETIGKKTASSAWDPATVMRILRDPRIAGFAAEVIYKKKPDGTPTTKIEGYRIQRDPITLRPVELDCGPIIEPAEWYELQAWLDGRGRGKGLSRGQAILSAMDKLYCECGAVMTSKRGEESIKDSYRCRRRKVVDPSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1874 - protein, 690 aa, Artificial Sequence
  synthetic polypeptide
MDTYAGAYDRQSRERENSSAASPATQRSANEDKAADLQREVERDGGRFRFVGHFSEAPGTSAFGTAERPEFERILNECRAGRLNMIIVYDVSRFSRLKVMDAIPIVSELLALGVTIVSTQEGVFRQGNVMDLIHLIMRLDASHKESSLKSAKILDTKNLQRELGGYVGGKAPYGFELVSETKEITRNGRMVNVVINKLAHSTTPLTGPFEFEPDVIRWWWREIKTHKHLPFKPGSQAAIHPGSITGLCKRMDADAVPTRGETIGKKTASSAWDPATVMRILRDPRIAGFAAEVIYKKKPDGTPTTKIEGYRIQRDPITLRPVELDCGPIIEPAEWYELQAWLDGRGRGKGLSRGQAILSAMDKLYCECGAVMTSKRGEESIKDSYRCRRRKVVDPSAPGQHEGTCNVSMAALDKFVAERIFNKIRHAESGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1875 - protein, 833 aa, Artificial Sequence
  synthetic polypeptide
MDTYAGAYDRQSRERENSSAASPATQRSANEDKAADLQREVERDGGRFRFVGHFSEAPGTSAFGTAERPEFERILNECRAGRLNMIIVYDVSRFSRLKVMDAIPIVSELLALGVTIVSTQEGVFRQGNVMDLIHLIMRLDASHKESSLKSAKILDTKNLQRELGGYVGGKAPYGFELVSETKEITRNGRMVNVVINKLAHSTTPLTGPFEFEPDVIRWWWREIKTHKHLPFKPGSQAAIHPGSITGLCKRMDADAVPTRGETIGKKTASSAWDPATVMRILRDPRIAGFAAEVIYKKKPDGTPTTKIEGYRIQRDPITLRPVELDCGPIIEPAEWYELQAWLDGRGRGKGLSRGQAILSAMDKLYCECGAVMTSKRGEESIKDSYRCRRRKVVDPSAPGQHEGTCNVSMAALDKFVAERIFNKIRHAEGDEETLALLWEAARRFGKLTEAPEKSGERANLVAERADALNALEELYEDRAAGAYDGPVGRKHFRKQQAALTLRQQGAEERLAELEAAEAPKLPLDQWFPEDADADPTGPKSWWGRASVDDKRVFVGLFVDKIVVTKSTTGRGSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1876 - protein, 634 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGSQAAIHPGSITGLCKRMDADAVPTRGETIGKKTASSAWDPATVMRILRDPRIAGFAAEVIYKKKPDGTPTTKIEGYRIQRDPITLRPVELDCGPIIEPAEWYELQAWLDGRGRGKGLSRGQAILSAMDKLYCECGAVMTSKRGEESIKDSYRCRRRKVVDPSAPGQHEGTCNVSMAALDKFVAERIFNKIRHAEGDEETLALLWEAARRFGKLTEAPEKSGERANLVAERADALNALEELYEDRAAGAYDGPVGRKHFRKQQAALTLRQQGAEERLAELEAAEAPKLPLDQWFPEDADADPTGPKSWWGRASVDDKRVFVGLFVDKIVVTKSTTGRGQGTPIEKRASITWAKPPTDDDEDDAQDGTEDVAAPKKKRKV

SEQ ID NO: 1877 - protein, 471 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTAPGQHEGTCNVSMAALDKFVAERIFNKIRHAEGDEETLALLWEAARRFGKLTEAPEKSGERANLVAERADALNALEELYEDRAAGAYDGPVGRKHFRKQQAALTLRQQGAEERLAELEAAEAPKLPLDQWFPEDADADPTGPKSWWGRASVDDKRVFVGLFVDKIVVTKSTTGRGQGTPIEKRASITWAKPPTDDDEDDAQDGTEDVAAPKKKRKV

SEQ ID NO: 1878 - protein, 439 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGDEETLALLWEAARRFGKLTEAPEKSGERANLVAERADALNALEELYEDRAAGAYDGPVGRKHFRKQQAALTLRQQGAEERLAELEAAEAPKLPLDQWFPEDADADPTGPKSWWGRASVDDKRVFVGLFVDKIVVTKSTTGRGQGTPIEKRASITWAKPPTDDDEDDAQDGTEDVAAPKKKRKV

SEQ ID NO: 1879 - protein, 296 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTQGTPIEKRASITWAKPPTDDDEDDAQDGTEDVAAPKKKRKV

SEQ ID NO: 1880 - protein, 344 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1881 - protein, 434 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRHSLPATPDTVEAFFIERAEELHRNTLSVYRWAISRVHRVAGCPDPCLDIYVEDRLKAIARKKVREGEAVKQASPFNEQHLLKLTSLWYRSSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1882 - protein, 472 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRHSLPATPDTVEAFFIERAEELHRNTLSVYRWAISRVHRVAGCPDPCLDIYVEDRLKAIARKKVREGEAVKQASPFNEQHLLKLTSLWYRSDKLLLRRNLALLAVAYESMLRASELANIRVSDMELAGDSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1883 - protein, 531 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRHSLPATPDTVEAFFIERAEELHRNTLSVYRWAISRVHRVAGCPDPCLDIYVEDRLKAIARKKVREGEAVKQASPFNEQHLLKLTSLWYRSDKLLLRRNLALLAVAYESMLRASELANIRVSDMELAGDGTAILTIPITKTNHSGEPDTCILSQDVVSLLMDYTEAGKLDMSSDGFLFVGVSKHNTCISGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1884 - protein, 539 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRHSLPATPDTVEAFFIERAEELHRNTLSVYRWAISRVHRVAGCPDPCLDIYVEDRLKAIARKKVREGEAVKQASPFNEQHLLKLTSLWYRSDKLLLRRNLALLAVAYESMLRASELANIRVSDMELAGDGTAILTIPITKTNHSGEPDTCILSQDVVSLLMDYTEAGKLDMSSDGFLFVGVSKHNTCIKPKKDKQTSGGSGSGSSGGSGTMEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHPKKKRKV

SEQ ID NO: 1885 - protein, 560 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTHSLPATPDTVEAFFIERAEELHRNTLSVYRWAISRVHRVAGCPDPCLDIYVEDRLKAIARKKVREGEAVKQASPFNEQHLLKLTSLWYRSDKLLLRRNLALLAVAYESMLRASELANIRVSDMELAGDGTAILTIPITKTNHSGEPDTCILSQDVVSLLMDYTEAGKLDMSSDGFLFVGVSKHNTCIKPKKDKQTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKDPKKKRKV

SEQ ID NO: 1886 - protein, 470 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTDKLLLRRNLALLAVAYESMLRASELANIRVSDMELAGDGTAILTIPITKTNHSGEPDTCILSQDVVSLLMDYTEAGKLDMSSDGFLFVGVSKHNTCIKPKKDKQTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKDPKKKRKV

SEQ ID NO: 1887 - protein, 432 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGTAILTIPITKTNHSGEPDTCILSQDVVSLLMDYTEAGKLDMSSDGFLFVGVSKHNTCIKPKKDKQTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKDPKKKRKV

SEQ ID NO: 1888 - protein, 373 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTKPKKDKQTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKDPKKKRKV

SEQ ID NO: 1889 - protein, 365 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHSGGSGSGSSGGSGTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKDPKKKRKV

SEQ ID NO: 1890 - DNA, 8890 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1891 - DNA, 8623 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1892 - DNA, 8002 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1893 - DNA, 7477 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1894 - DNA, 7459 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1895 - DNA, 7405 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1896 - DNA, 7189 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1897 - DNA, 7102 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1898 - DNA, 6445 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1899 - DNA, 8707 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1900 - DNA, 8614 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1901 - DNA, 8509 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1902 - DNA, 8365 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1903 - DNA, 8203 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1904 - DNA, 8134 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1905 - DNA, 7942 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1906 - DNA, 7735 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1907 - DNA, 7633 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1908 - DNA, 7426 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1909 - DNA, 8983 bp, Artificial Sequence; identical to SEQ ID NO: 1406
  synthetic vector

SEQ ID NO: 1910 - DNA, 8440 bp, Artificial Sequence; identical to SEQ ID NO: 1407
  synthetic vector

SEQ ID NO: 1911 - DNA, 8614 bp, Artificial Sequence; identical to SEQ ID NO: 1408
  synthetic vector

SEQ ID NO: 1912 - DNA, 9004 bp, Artificial Sequence; identical to SEQ ID NO: 1409
  synthetic vector

SEQ ID NO: 1913 - DNA, 8461 bp, Artificial Sequence; identical to SEQ ID NO: 1410
  synthetic vector

SEQ ID NO: 1914 - DNA, 8635 bp, Artificial Sequence; identical to SEQ ID NO: 1411
  synthetic vector

SEQ ID NO: 1915 - DNA, 8410 bp, Artificial Sequence; identical to SEQ ID NO: 1412
  synthetic vector

SEQ ID NO: 1916 - DNA, 8446 bp, Artificial Sequence; identical to SEQ ID NO: 1413
  synthetic vector

SEQ ID NO: 1917 - DNA, 8584 bp, Artificial Sequence; identical to SEQ ID NO: 1414
  synthetic vector

SEQ ID NO: 1918 - DNA, 10108 bp, Artificial Sequence
  synthetic vector
cgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtg

SEQ ID NO: 1919 - DNA, 3651 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1920 - DNA, 3384 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1921 - DNA, 2763 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1922 - DNA, 2238 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1923 - DNA, 2220 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1924 - DNA, 2166 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1925 - DNA, 1950 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1926 - DNA, 1863 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1927 - DNA, 1206 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1928 - DNA, 3468 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1929 - DNA, 3375 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1930 - DNA, 3270 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1931 - DNA, 3126 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1932 - DNA, 2964 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1933 - DNA, 2895 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1934 - DNA, 2703 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1935 - DNA, 2496 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1936 - DNA, 2394 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1937 - DNA, 2187 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1938 - DNA, 3744 bp, Artificial Sequence; identical to SEQ ID NO: 1478
  synthetic polynucleotide

SEQ ID NO: 1939 - DNA, 3201 bp, Artificial Sequence; identical to SEQ ID NO: 1479
  synthetic polynucleotide

SEQ ID NO: 1940 - DNA, 3375 bp, Artificial Sequence; identical to SEQ ID NO: 1480
  synthetic polynucleotide

SEQ ID NO: 1941 - DNA, 3765 bp, Artificial Sequence; identical to SEQ ID NO: 1481
  synthetic polynucleotide

SEQ ID NO: 1942 - DNA, 3222 bp, Artificial Sequence; identical to SEQ ID NO: 1482
  synthetic polynucleotide

SEQ ID NO: 1943 - DNA, 3396 bp, Artificial Sequence; identical to SEQ ID NO: 1483
  synthetic polynucleotide

SEQ ID NO: 1944 - DNA, 3171 bp, Artificial Sequence; identical to SEQ ID NO: 1484
  synthetic polynucleotide

SEQ ID NO: 1945 - DNA, 3207 bp, Artificial Sequence; identical to SEQ ID NO: 1485
  synthetic polynucleotide

SEQ ID NO: 1946 - DNA, 3345 bp, Artificial Sequence; identical to SEQ ID NO: 1486
  synthetic polynucleotide

SEQ ID NO: 1947 - DNA, 4869 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1948 - protein, 1216 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1949 - protein, 1127 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1950 - protein, 920 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1951 - protein, 745 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1952 - protein, 739 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1953 - protein, 721 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1954 - protein, 649 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1955 - protein, 620 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1956 - protein, 401 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 1957 - protein, 1155 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1958 - protein, 1124 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1959 - protein, 1089 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1960 - protein, 1041 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1961 - protein, 987 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1962 - protein, 964 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1963 - protein, 900 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1964 - protein, 831 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1965 - protein, 797 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1966 - protein, 728 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1967 - protein, 1247 aa, Artificial Sequence; identical to SEQ ID NO: 1550
  synthetic polypeptide

SEQ ID NO: 1968 - protein, 1066 aa, Artificial Sequence; identical to SEQ ID NO: 1551
  synthetic polypeptide

SEQ ID NO: 1969 - protein, 1124 aa, Artificial Sequence; identical to SEQ ID NO: 1552
  synthetic polypeptide

SEQ ID NO: 1970 - protein, 1254 aa, Artificial Sequence; identical to SEQ ID NO: 1553
  synthetic polypeptide

SEQ ID NO: 1971 - protein, 1073 aa, Artificial Sequence; identical to SEQ ID NO: 1554
  synthetic polypeptide

SEQ ID NO: 1972 - protein, 1131 aa, Artificial Sequence; identical to SEQ ID NO: 1555
  synthetic polypeptide

SEQ ID NO: 1973 - protein, 1056 aa, Artificial Sequence; identical to SEQ ID NO: 1556
  synthetic polypeptide

SEQ ID NO: 1974 - protein, 1068 aa, Artificial Sequence; identical to SEQ ID NO: 1557
  synthetic polypeptide

SEQ ID NO: 1975 - protein, 1114 aa, Artificial Sequence; identical to SEQ ID NO: 1558
  synthetic polypeptide

SEQ ID NO: 1976 - protein, 1622 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSSGGSGSGSSGGSGTMAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1977 - DNA, 357 bp, Artificial Sequence
  synthetic polynucleotide
gaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcat

SEQ ID NO: 1978 - DNA, 357 bp, Artificial Sequence
  synthetic polynucleotide
gaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccat

SEQ ID NO: 1979 - DNA, 723 bp, Artificial Sequence
  synthetic polynucleotide
atggaagtgcaactccaagctagcggaggtggtctggtacaagctggcggcagtttgaggctttcttgtacagctagtgggcggacgggcacaatttattctatggcttggttccgacaggctcctggaaaagagagagaatttcttgcgaccgtcggttggtccagcggaataacttattatatggacagcgttaagggaaggtttacgataagtagagacaatgcaaagaactccgcctacttgcaaatgaacagtttgaaacctgaggatacagcagtctactattgtaccgctactcgcgcttacagcgtgggatacgattactggggtcaggggactcaggtcaccgttagccatgtcgaggaagttcaactgcaagcttctggcggcggcctggttcaagctggcggctctctgcgtctgtcttgcactgcttctggccgtactggcactatctactctatggcttggttccgtcaagctcctggcaaagaacgtgaattcctggctactgttggctggtcttctggcatcacttactacatggattctgttaaaggccgtttcactatctctcgtgataacgctaaaaactctgcttacctgcaaatgaactctctgaaacctgaagatactgctgtttactactgcactgctactcgtgcttactctgttggctacgattactggggccaaggcactcaagttactgtttctcat

SEQ ID NO: 1980 - protein, 119 aa, Artificial Sequence
  synthetic polypeptide
EVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSH

SEQ ID NO: 1981 - protein, 241 aa, Artificial Sequence
  synthetic polypeptide
MEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSHVEEVQLQASGGGLVQAGGSLRLSCTASGRTGTIYSMAWFRQAPGKEREFLATVGWSSGITYYMDSVKGRFTISRDNAKNSAYLQMNSLKPEDTAVYYCTATRAYSVGYDYWGQGTQVTVSH

SEQ ID NO: 1982 - protein, 13 aa, Artificial Sequence
  synthetic polypeptide
SSGGSGSGSSGGS

SEQ ID NO: 1983 - protein, 11 aa, Artificial Sequence
  synthetic polypeptide
SGGGSGGSGSS

SEQ ID NO: 1984 - DNA, 10105 bp, Artificial Sequence
  synthetic vector
cgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtg

SEQ ID NO: 1985 - DNA, 4866 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1986 - protein, 1621 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSSGGSGSGSSGGSGTMAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1987 - DNA, 7531 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1988 - DNA, 8620 bp, Artificial Sequence
  synthetic vector
ggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtg

SEQ ID NO: 1989 - DNA, 7588 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1990 - DNA, 8563 bp, Artificial Sequence
  synthetic vector
tgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctc

SEQ ID NO: 1991 - DNA, 7603 bp, Artificial Sequence
  synthetic vector
tgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctc

SEQ ID NO: 1992 - DNA, 8548 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1993 - DNA, 7804 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1994 - DNA, 8347 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1995 - DNA, 8155 bp, Artificial Sequence
  synthetic vector
cggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcggggggga

SEQ ID NO: 1996 - DNA, 7996 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1997 - DNA, 8329 bp, Artificial Sequence
  synthetic vector
tgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctgg

SEQ ID NO: 1998 - DNA, 7822 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1999 - DNA, 8698 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2000 - DNA, 7453 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2001 - DNA, 8818 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2002 - DNA, 7333 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 2003 - DNA, 8833 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2004 - DNA, 7318 bp, Artificial Sequence
  synthetic vector
ttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggag

SEQ ID NO: 2005 - DNA, 8869 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2006 - DNA, 7282 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 2007 - DNA, 9166 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2008 - DNA, 6985 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2009 - DNA, 9493 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2010 - DNA, 2292 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2011 - DNA, 3381 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2012 - DNA, 2349 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2013 - DNA, 3324 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2014 - DNA, 2364 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2015 - DNA, 3309 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtatga

SEQ ID NO: 2016 - DNA, 2565 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2017 - DNA, 3108 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2018 - DNA, 2916 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2019 - DNA, 2757 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2020 - DNA, 3090 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2021 - DNA, 2583 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2022 - DNA, 3459 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2023 - DNA, 2214 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2024 - DNA, 3579 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2025 - DNA, 2094 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2026 - DNA, 3594 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2027 - DNA, 2079 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2028 - DNA, 3630 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2029 - DNA, 2043 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2030 - DNA, 3927 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2031 - DNA, 1746 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtataa

SEQ ID NO: 2032 - DNA, 4254 bp, Artificial Sequence
  synthetic polynucleotide
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggatccgagggagctcccaagaaaaagcgcaaggtatga

SEQ ID NO: 2033 - protein, 763 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILESGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2034 - protein, 1126 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTTENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2035 - protein, 782 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2036 - protein, 1107 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2037 - protein, 787 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2038 - protein, 1102 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2039 - protein, 854 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2040 - protein, 1035 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2041 - protein, 971 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2042 - protein, 918 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2043 - protein, 1029 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2044 - protein, 860 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2045 - protein, 1152 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2046 - protein, 737 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2047 - protein, 1192 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2048 - protein, 697 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2049 - protein, 1197 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2050 - protein, 1197 aa, Artificial Sequence; identical to SEQ ID NO: 2049
  synthetic polypeptide

SEQ ID NO: 2051 - protein, 1209 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2052 - protein, 680 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2053 - protein, 1308 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2054 - protein, 581 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2055 - protein, 1417 aa, Artificial Sequence
  synthetic polypeptide
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGAPKKKRKV

SEQ ID NO: 2056 - DNA, 6436 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2057 - DNA, 8776 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2058 - DNA, 6490 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2059 - DNA, 8722 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 2060 - DNA, 9502 bp, Artificial Sequence
  synthetic vector
tgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgc

SEQ ID NO: 2061 - DNA, 5710 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 2062 - DNA, 6796 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2063 - DNA, 8416 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2064 - DNA, 6874 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2065 - DNA, 8338 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2066 - DNA, 7093 bp, Artificial Sequence
  synthetic vector
tgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctgg

SEQ ID NO: 2067 - DNA, 8119 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2068 - DNA, 9295 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2069 - DNA, 5917 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2070 - DNA, 7636 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2071 - DNA, 7576 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 2072 - DNA, 7648 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2073 - DNA, 7564 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 2074 - DNA, 7666 bp, Artificial Sequence
  synthetic vector
cggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcggggggga

SEQ ID NO: 2075 - DNA, 7546 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2076 - DNA, 9205 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2077 - DNA, 6007 bp, Artificial Sequence
  synthetic vector
tgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctc

SEQ ID NO: 2078 - DNA, 9538 bp, Artificial Sequence
  synthetic vector
tgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctc

SEQ ID NO: 2079 - DNA, 5674 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgtggtggaaatcaaggccctgcctgagatcgccatgagcatcaagaaggcctttggggagtacgccatcatgaagggatcccttcaactgcctccacttgaaagactgacactgtaagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 2080 - DNA, 6433 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2081 - DNA, 6487 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2082 - DNA, 9499 bp, Artificial Sequence
  synthetic vector
tgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgc

SEQ ID NO: 2083 - DNA, 6793 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2084 - DNA, 6871 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 2085 - DNA, 7090 bp, Artificial Sequence
  synthetic vector
tgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctgg

SEQ ID NO: 2086 - DNA, 9292 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2087 - DNA, 7633 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2088 - DNA, 7645 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2089 - DNA, 7663 bp, Artificial Sequence
  synthetic vector
cggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcggggggga

SEQ ID NO: 2090 - DNA, 9202 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2091 - DNA, 9535 bp, Artificial Sequence
  synthetic vector
tgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctc

SEQ ID NO: 2092 - DNA, 8551 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 2093 - DNA, 1197 bp, Artificial Sequence
  synthetic polynucleotide
atgaacatccccgctctggtggaaaaccagaagaagtactttggcacctacagcgtgatggccatgctgaacgctcagaccgtgctggaccactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2094 - DNA, 3537 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2095 - DNA, 1251 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2096 - DNA, 3483 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2097 - DNA, 4263 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2098 - DNA, 471 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2099 - DNA, 1557 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2100 - DNA, 3177 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2101 - DNA, 1635 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2102 - DNA, 3099 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2103 - DNA, 1854 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2104 - DNA, 2880 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2105 - DNA, 4056 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2106 - DNA, 678 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2107 - DNA, 2397 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2108 - DNA, 2337 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2109 - DNA, 2409 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2110 - DNA, 2325 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2111 - DNA, 2427 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2112 - DNA, 2307 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2113 - DNA, 3966 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2114 - DNA, 768 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtaa

SEQ ID NO: 2115 - DNA, 4299 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 2116 - DNA, 435 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgtggtggaaatcaaggccctgcctgagatcgccatgagcatcaagaaggcctttggggagtacgccatcatgaagggatcccttcaactgcctccacttgaaagactgacactgtaa

SEQ ID NO: 2117 - DNA, 1194 bp, Artificial Sequence
  synthetic polynucleotide
atgaacatccccgctctggtggaaaaccagaagaagtactttggcacctacagcgtgatggccatgctgaacgctcagaccgtgctggaccactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2118 - DNA, 1248 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2119 - DNA, 4260 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2120 - DNA, 1554 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2121 - DNA, 1632 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2122 - DNA, 1851 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2123 - DNA, 4053 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2124 - DNA, 2394 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2125 - DNA, 2406 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2126 - DNA, 2424 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2127 - DNA, 3963 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2128 - DNA, 4296 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 2129 - DNA, 3312 bp, Artificial Sequence
  synthetic polynucleotide
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaaccactacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatatcatggaagagttcaacaaatacgaccagtgcaggcccgagatcagctccatcgtgttcaacctggaaaagtgggccttcgacacataccccgagctgtctgccagagtggaccgggaagagaaggtggacttcaagagcatcctgaaaatcctgctgaacaacaagaacatcaacaaagagcagagcgacatcctgcggaagatccggaacgccttcgatcacaacaattaccccgacaaaggcgtggtggaaatcaaggccctgcctgagatcgccatgagcatcaagaaggcctttggggagtacgccatcatgaagggatcccttcaactgcctccacttgaaagactgacactgtga

SEQ ID NO: 2130 - protein, 398 aa, Artificial Sequence
  synthetic polypeptide
MNIPALVENQKKYFGTYSVMAMLNAQTVLDHSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2131 - protein, 1178 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2132 - protein, 416 aa, Artificial Sequence
  synthetic polypeptide
MNIPALVENQKKYFGTYSVMAMLNAQTVLDHIQKVADIEGEQNENNENLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2133 - protein, 1160 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2134 - protein, 1420 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2135 - protein, 156 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTNAFDHNNYPDKGVVEIKALPEIAMSIKKAFGEYAIMKGSLQLPPLERLTL

SEQ ID NO: 2136 - protein, 518 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2137 - protein, 1058 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2138 - protein, 544 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2139 - protein, 1032 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2140 - protein, 617 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2141 - protein, 959 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2142 - protein, 1351 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDISGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2143 - protein, 225 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2144 - protein, 798 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2145 - protein, 778 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2146 - protein, 802 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2147 - protein, 774 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2148 - protein, 808 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2149 - protein, 768 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2150 - protein, 1321 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2151 - protein, 255 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2152 - protein, 1432 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 2153 - protein, 144 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTVVEIKALPEIAMSIKKAFGEYAIMKGSLQLPPLERLTL

SEQ ID NO: 2154 - protein, 397 aa, Artificial Sequence
  synthetic polypeptide
MNIPALVENQKKYFGTYSVMAMLNAQTVLDHSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2155 - protein, 415 aa, Artificial Sequence
  synthetic polypeptide
MNIPALVENQKKYFGTYSVMAMLNAQTVLDHIQKVADIEGEQNENNENLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2156 - protein, 1419 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2157 - protein, 517 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2158 - protein, 543 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2159 - protein, 616 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2160 - protein, 1350 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDISGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2161 - protein, 797 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2162 - protein, 801 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2163 - protein, 807 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2164 - protein, 1320 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2165 - protein, 1431 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 2166 - protein, 1103 aa, Artificial Sequence
  synthetic polypeptide
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTL

SEQ ID NO: 2167 - protein, 1182 aa, Artificial Sequence
  synthetic polypeptide
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 2168 - protein, 8 aa, Artificial Sequence
  synthetic polypeptide
LDLASLIL

SEQ ID NO: 2169 - protein, 258 aa, Artificial Sequence
  synthetic polypeptide
GGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYKGSEGA
